United States Patent 7,667,001 (NUCLEOTIDE AND AMINO ACID SEQUENCES, AND ASSAYS AND METHODS OF USE THEREOF FOR DIAGNOSIS OF LUNG CANCER) - sequence listing, part 2

SEQ ID NO: 1699 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 1700 - protein, 504 aa, Homo sapiens
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPQGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 1701 - protein, 295 aa, Homo sapiens
MLQGPGSLLLLFLASHCCLGSARGLFLFGQPDFSYKRSNCKPIPANLQLCHGIEYQNMRLPNLLGHETMKEVLEQAGAWIPLVMKQCHPDTKKFLCSLFAPVCLDDLDETIQPCHSLCVQVKDRCAPVMSAFGFPWPDMLECDRFPQDNDLCIPLASSDHLLPATEEAPKVCEACKNKNDDDNDIMETLCKNDFALKIKVKEITYINRDTKIILETKSKTIYKLNGVSERDLKKSVLWLKDSLQCTCEEMNDINAPYLVMGQKQGGELVITSVKRWQKGQREFKRISRSIRKLQC

SEQ ID NO: 1702 - protein, 18 aa, Artificial
  Synthetic peptide
AFCQLIYPGKGRTRARMF

SEQ ID NO: 1703 - protein, 396 aa, Homo sapiens
MQLKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 1704 - protein, 216 aa, Homo sapiens
MRPRSGPTRNPRLRAFAGVPTRGRTRGQSRRCAAEASAGPERDARPGAPAAGTMGAAHSASEEVRELEGKTGFSSDQIEQLHRRFKQLSGDQPTIRKENFNNVPDLELNPIRSKIVRAFFDNRNLRKGPSGLADEINFEDFLTIMSYFRPIDTTMDEEQVELSRKEKLRFLFHMYDSDSDGRITLEEYRNVKWSRSCCRETLTSRRSPLAPSPTGP

SEQ ID NO: 1705 - protein, 275 aa, Homo sapiens
MRILQLILLALATGLVGGETRIIKGFECKPHSQPWQAALFEKTRLLCGATLIAPRWLLTAAHCLKPWVSLTSPTHVSPDLSSSNYCLSHLSRYIVHLGQHNLQKEEGCEQTRTATESFPHPGFNNSLPNKDHRNDIMLVKMASPVSITWAVRPLTLSSRCVTAGTSCLISGWGSTSSPQLRLPHTLRCANITIIEHQKCENAYPGNITDTMVCASVQEGGKDSCQGDSGGPLVCNQSLQGIISWGQDPCAITRKPGVYTKVCKYVDWIQETMKNN

SEQ ID NO: 1706 - protein, 111 aa, Homo sapiens [sequence omitted]

SEQ ID NO: 1707 - protein, 112 aa, Homo sapiens; identical to SEQ ID NO: 1409

SEQ ID NO: 1708 - protein, 141 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLALFSAHC

SEQ ID NO: 1709 - protein, 165 aa, Homo sapiens
MWVLGIAATFCGLFLLPGFALQIQCYQCEEFQLNNDCSSPEFIVNCTVNVQDMCQKEVMEQSAGIMYRKSCASSAACLIASAGYQSFCSPGKLNSVCISCCNTPLCNGPRPKKRGSSASALRPGLRTTILFLKLASSRHTAELKEMPPPPALFFQPSPPTPHLPE

SEQ ID NO: 1710 - protein, 164 aa, Homo sapiens [sequence omitted]

SEQ ID NO: 1711 - DNA, 2201 bp, Homo sapiens
cgggatttgggtcgcggttcttgtttgtggatcgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtggagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattcctcctgatcagcagaggttgatctttgccggaaaacagctggaagatggtcgtaccctgtctgactacaacatccagaaagagtccaccttgcacctggtactccgtctcagaggtgggatgcaaatcttcgtgaagacactcactggcaagaccatcacccttgaggtcgagcccagtgacactatcgagaacgtcaaagcaaagatccaagacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaagtggagccgagtgacaccattgagaatgtcaaggcaaagatccaagacaaggaaggcatccctcctgaccagcagaggttgatctttgccggaaaacagctggaagatggtcgtaccctgtctgactacaacatccagaaagagtccaccttgcacctggtgctccgtctcagaggtgggatgcagatcttcgtgaagaccctgactggtaagaccatcactctcgaggtggagccgagtgacaccattgagaatgtcaaggcaaagatccaagacaaggaaggcatccctcctgatcagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtcttagaggtgggatgcagatcttcgtgaagaccctgactggtaagaccatcactctcgaagtggagccgagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattcccaaaaaaaaaaaaaaaaaaaaaaaa

SEQ ID NO: 1712 - DNA, 2277 bp, Homo sapiens
gactgcgcggcggcaacagcagacatgtcgggggtccggggcctgtcgcggctgctgagcgctcggcgcctggcgctggccaaggcgtggccaacagtgttgcaaacaggaacccgaggttttcacttcactgttgatgggaacaagagggcatctgctaaagtttcagattccatttctgctcagtatccagtagtggatcatgaatttgatgcagtggtggtaggcgctggaggggcaggcttgcgagctgcatttggcctttctgaggcagggtttaatacagcatgtgttaccaagctgtttcctaccaggtcacacactgttgcagcgcagggaggaatcaatgctgctctggggaacatggaggaggacaactggaggtggcatttctacgacaccgtgaagggctccgactggctgggggaccaggatgccatccactacatgacggagcaggcccccgccgccgtggtcgagctagaaaattatggcatgccgtttagcagaactgaagatgggaagatttatcagcgtgcatttggtggacagagcctcaagtttggaaagggcgggcaggcccatcggtgctgctgtgtggctgatcggactggccactcgctattgcacaccttatatggacggtctctgcgatatgataccagctattttgtggagtattttgccttggatctcctgatggagaacggggagtgccgtggtgtcatcgcactgtgcatagaggacgggtccatccatcgcataagagcaaagaacactgttgttgccacaggaggctacgggcgcacctacttcagctgcacgtctgcccacaccagcactggcgacggcacggccatgatcaccagggcaggccttccttgccaggacctagagtttgttcagttccaccccacaggcatatatggtgctggttgtctcattacggaaggatgtcgtggagagggaggcattctcattaacagtcaaggcgaaaggtttatggagcgatacgcccctgtcgcgaaggacctggcgtctagagatgtggtgtctcggtcgatgactctggagatccgagaaggaagaggctgtggccctgagaaagatcacgtctacctgcagctgcaccacctacctccagagcagctggccacgcgcctgcctggcatttcagagacagccatgatcttcgctggcgtggacgtcacgaaggagccgatccctgtcctccccaccgtgcattataacatgggcggcattcccaccaactacaaggggcaggtcctgaggcacgtgaatggccaggatcagattgtgcccggcctgtacgcctgtggggaggccgcctgtgcctcggtacatggtgccaaccgcctcggggcaaactcgctcttggacctggttgtctttggtcgggcatgtgccctgagcatcgaagagtcatgcaggcctggagataaagtccctccaattaaaccaaacgctggggaagaatctgtcatgaatcttgacaaattgagatttgctgatggaagcataagaacatcggaactgcgactcagcatgcagaagtcaatgcaaaatcatgctgccgtgttccgtgtgggaagcgtgttgcaagaaggttgtgggaaaatcagcaagctctatggagacctaaagcacctgaagacgttcgaccggggaatggtctggaacacagacctggtggagaccctggagctgcagaacctgatgctgtgtgcgctgcagaccatctacggagcagaggcgcggaaggagtcacggggcgcgcatgccagggaagactacaaggtgcggattgatgagtacgattactccaagcccatccaggggcaacagaagaagccctttgaggagcactggaggaagcacaccctgtcctttgtggacgttggcactgggaaggtcactctggaatatagacccgtaatcgacaaaactttgaacgaggctgactgtgccaccatcccgccagccattcgctcctactgatgagacaagatgtggtgatgacagaatcagcttttgtaattatgtataatagctcatgcatgtgtccatgtcataactgtcttcatacgcttctgcactctggggaagaaggagtacattgaagggagattggcacctagtggctgggagcttgccaggaacccagtggccagggagcgtggcacttacctttgtcccttgcttcattcttgtgagatgataaaactgggcacagctcttaaataaaatataaatgag

SEQ ID NO: 1713 - DNA, 1536 bp, Homo sapiens
gtgacgcgaggctctgcggagaccaggagtcagactgtaggacgacctcgggtcccacgtgtccccggtactcgccggccggagcccccggcttcccggggccgggggaccttagcggcacccacacacagcctactttccaagcggagccatgtctggtaacggcaatgcggctgcaacggcggaagaaaacagcccaaagatgagagtgattcgcgtgggtacccgcaagagccagcttgctcgcatacagacggacagtgtggtggcaacattgaaagcctcgtaccctggcctgcagtttgaaatcattgctatgtccaccacaggggacaagattcttgatactgcactctctaagattggagagaaaagcctgtttaccaaggagcttgaacatgccctggagaagaatgaagtggacctggttgttcactccttgaaggacctgcccactgtgcttcctcctggcttcaccatcggagccatctgcaagcgggaaaaccctcatgatgctgttgtctttcacccaaaatttgttgggaagaccctagaaaccctgccagagaagagtgtggtgggaaccagctccctgcgaagagcagcccagctgcagagaaagttcccgcatctggagttcaggagtattcggggaaacctcaacacccggcttcggaagctggacgagcagcaggagttcagtgccatcatcctggcaacagctggcctgcagcgcatgggctggcacaaccgggtggggcagatcctgcaccctgaggaatgcatgtatgctgtgggccagggggccttgggcgtggaagtgcgagccaaggaccaggacatcttggatctggtgggtgtgctgcacgatcccgagactctgcttcgctgcatcgctgaaagggccttcctgaggcacctggaaggaggctgcagtgtgccagtagccgtgcatacagctatgaaggatgggcaactgtacctgactggaggagtctggagtctagacggctcagatagcatacaagagaccatgcaggctaccatccatgtccctgcccagcatgaagatggccctgaggatgacccacagttggtaggcatcactgctcgtaacattccacgagggccccagttggctgcccagaacttgggcatcagcctggccaacttgttgctgagcaaaggagccaaaaacatcctggatgttgcacggcagcttaacgatgcccattaactggtttgtggggcacagatgcctgggttgctgctgtccagtgcctacatcccgggcctcagtgccccattctcactgctatctggggagtgattaccccgggagactgaactgcagggttcaagccttccagggatttgcctcaccttggggccttgatgactgccttgcctcctcagtatgtgggggcttcatctctttagagaagtccaagcaacagcctttgaatgtaaccaatcctactaataaaccagttctgaaggtaaaaaaaaaaaaaaaaaaaaaaaaaaaaaaaaaaa

SEQ ID NO: 1714 - DNA, 1331 bp, Homo sapiens
tcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctgaggatttggaaagggtgtttattcctcatggactaattatggacaggactgaacgtcttgctcgagatgtgatgaaggagatgggaggccatcacattgtagccctctgtgtgctcaaggggggctataaattctttgctgacctgctggattacatcaaagcactgaatagaaatagtgatagatccattcctatgactgtagattttatcagactgaagagctattgtaatgaccagtcaacaggggacataaaagtaattggtggagatgatctctcaactttaactggaaagaatgtcttgattgtggaagatataattgacactggcaaaacaatgcagactttgctttccttggtcaggcagtataatccaaagatggtcaaggtcgcaagcttgctggtgaaaaggaccccacgaagtgttggatataagccagactttgttggatttgaaattccagacaagtttgttgtaggatatgcccttgactataatgaatacttcagggatttgaatcatgtttgtgtcattagtgaaactggaaaagcaaaatacaaagcctaagatgagagttcaagttgagtttggaaacatctggagtcctattgacatcgccagtaaaattatcaatgttctagttctgtggccatctgcttagtagagctttttgcatgtatcttctaagaattttatctgttttgtactttagaaatgtcagttgctgcattcctaaactgtttatttgcactatgagcctatagactatcagttccctttgggcggattgttgtttaacttgtaaatgaaaaaattctcttaaaccacagcactattgagtgaaacattgaactcatatctgtaagaaataaagagaagatatattagttttttaattggtattttaatttttatatatgcaggaaagaatagaagtgattgaatattgttaattataccaccgtgtgttagaaaagtaagaagcagtcaattttcacatcaaagacagcatctaagaagttttgttctgtcctggaattattttagtagtgtttcagtaatgttgactgtattttccaacttgttcaaattattaccagtgaatctttgtcagcagttcccttttaaatgcaaatcaataaattcccaaaaattt

SEQ ID NO: 1715 - DNA, 748 bp, Homo sapiens
gcagataatgggaggagccgggcccgagcgagctctttcctttcgctgctgcggccgcagccatgagtatgctcaggcttcagaagaggctcgcctctagtgtcctccgctgtggcaagaagaaggtctggttagaccccaatgagaccaatgaaatcgccaatgccaactcccgtcagcagatccggaagctcatcaaagatgggctgatcatccgcaagcctgtgacggtccattcccgggctcgatgccggaaaaacaccttggcccgccggaagggcaggcacatgggcataggtaagcggaagggtacagccaatgcccgaatgccagagaaggtcacatggatgaggagaatgaggattttgcgccggctgctcagaagataccgtgaatctaagaagatcgatcgccacatgtatcacagcctgtacctgaaggtgaaggggaatgtgttcaaaaacaagcggattctcatggaacacatccacaagctgaaggcagacaaggcccgcaagaagctcctggctgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgcaaaaaaaaaaaaaaaa

SEQ ID NO: 1716 - DNA, 1867 bp, Homo sapiens
ggttcgctgtggcgggcgcctgggccgccggctgtttaacttcgcttccgctggcccatagtgatctttgcagtgacccagcagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttaaaaaaaaaaaaaaaaaaaaaa

SEQ ID NO: 1717 - protein, 33 aa, Artificial
  Synthetic peptide
NSPTPRLLPNMGGAPGRCPRPSLGAWRGASCWC

SEQ ID NO: 1718 - protein, 15 aa, Artificial
  Synthetic peptide
ECLTVNPSLQIPLNP

SEQ ID NO: 1719 - protein, 18 aa, Artificial
  Synthetic peptide
ECVCSKGFPFPLIGDSEG

SEQ ID NO: 1720 - protein, 49 aa, Artificial
  Synthetic peptide
VRGGTAGYLGEETRGQRPGCDSQSHTGPSKKPSAPSPLPAGTSWDRGVP

SEQ ID NO: 1721 - protein, 17 aa, Artificial
  Synthetic peptide
RECLLPWLPLQISEGRS

SEQ ID NO: 1722 - protein, 139 aa, Artificial
  Synthetic peptide
LTSFQLPNAPLFLRRPRLRLFSCPLDPLSVSWTPSYPLNTASLPLPSLSAQLPDPETWTLTCCVFDPCFLALGFLLPPPSILCSVPWIFTAFPRIVFFFFFFLRQVLALSPRQESSVRSWLIATSTSWVQAILLPQPLE

SEQ ID NO: 1723 - protein, 57 aa, Artificial
  Synthetic peptide
PQNPNSQPRAAGSLEVIISHPFVRRLEILISPFQFQNSIPKNSQIVPAASPRGTSSP

SEQ ID NO: 1724 - protein, 51 aa, Artificial
  Synthetic peptide
PELRQPARLGLPECWDYRHEPRCPAQMGSHFIVQAGLKLLASSKPPKCWDY

SEQ ID NO: 1725 - protein, 5 aa, Artificial
  Synthetic peptide
VRKSW

SEQ ID NO: 1726 - protein, 6 aa, Artificial
  Synthetic peptide
MATYIH

SEQ ID NO: 1727 - protein, 19 aa, Artificial
  Synthetic peptide
MTQNFRLMWNILLFPLNFS

SEQ ID NO: 1728 - protein, 60 aa, Artificial
  Synthetic peptide
VKNAIYFFFHKVLLLLFVVDVCSRNLIGIEAFHNYRIMWKFLGRCPFTASYKLIITEFRK

SEQ ID NO: 1729 - protein, 19 aa, Artificial
  Synthetic peptide
MTQNFRLMWNILLFPLNFS

SEQ ID NO: 1730 - protein, 28 aa, Artificial
  Synthetic peptide
VSSLCLNGTEKKIKDGREESFSVEISLA

SEQ ID NO: 1731 - protein, 13 aa, Artificial
  Synthetic peptide
DFLAAHVFGKLLE

SEQ ID NO: 1732 - protein, 30 aa, Artificial
  Synthetic peptide
MPASARLAGAGLLLAFLRALGCAGRAPGLS

SEQ ID NO: 1733 - protein, 1120 aa, Artificial
  Synthetic peptide
LDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRVHDVIQQLPPPHYRTLEYLLRHLARMARHSANTSMHARNLAIVWAPNLLRSMELESVGMGGAAAFREVRVQSVVVEFLLTHVDVLFSDTFTSAGLDPAGRCLLPRPKSLAGSCPSTRLLTLEEAQARTQGRLGTPTEPTTPKAPASPAERRKGERGEKQRKPGGSSWKTFFALGRGPSVPRKKPLPWLGGTRAPPQPSGSRPDTVTLRSAKSEESLSSQASGAGLQRLHRLRRPHSSSDAFPVGPAPAGSCESLSSSSSSESSSSESSSSSSESSAAGLGALSGSPSHRTSAWLDDGDELDFSPPRCLEGLRGLDFDPLTFRCSSPTPGDPAPPASPAPPAPASAFPPRVTPQAISPRGPTSPASPAALDISEPLAVSVPPAVLELLGAGGAPASATPTPALSPGRSLRPHLIPLLLRGAEAPLTDACQQEMCSKLRGAQGPLGPDMESPLPPPPLSLLRPGGAPPPPPKNPARLMALALAERAQQVAEQQSQQECGGTPPASQSPFHRSLSLEVGGEPLGTSGSGPPPNSLAHPGAWVPGPPPYLPRQQSDGSLLRSQRPMGTSRRGLRGPAQVSAQLRAGGGGRDAPEAAAQSPCSVPSQVPTPGFFSPAPRECLPPFLGVPKPGLYPLGPPSFQPSSPAPVWRSSLGPPAPLDRGENLYYEIGASEGSPYSGPTRSWSPFRSMPPDRLNASYGMLGQSPPLHRSPDFLLSYPPAPSCFPPDHLGYSAPQHPARRPTPPEPLYVNLALGPRGPSPASSSSSSPPAHPRSRSDPGPPVPRLPQKQRAPWGPRTPHRVPGPWGPPEPLLLYRAAPPAYGRGGELHRGSLYRNGGQRGEGAGPPPPYPTPSWSLHSEGQTRSYC

SEQ ID NO: 1734 - protein, 443 aa, Artificial
  Synthetic peptide
MLSLSLCSHLWGPLILSALQARSTDSLDGPGEGSVQPLPTAGGPSVKGKPGKRLSAPRGPFPRLADCAHFHYENVDFGHIQLLLSPDREGPSLSGENELVFGVQVTCQGRSWPVLRSYDDFRSLDAHLHRCIFDRRFSCLPELPPPPEGARAAQMLVPLLLQYLETLSGLVDSNLNCGPVLTWMELDNHGRRLLLSEEASLNIPAVAAAHVIKRYTAQAPDELSFEVGDIVSVIDMPPTEDRSWWRGKRGFQVGFFPSECVELFTERPGPGLKADADGPPCGIPAPQGISSLTSAVPRPRGKLAGLLRTFMRSRPSRQRLRQRGILRQRVFGCDLGEHLSNSGQDVPQVLRCCSEFIEAHGVVDGIYRLSGVSSNIQRLRHEFDSERIPELSGPAFLQDIHSVSSLCKLYFRELPNPLLTYQLYGKFSEAMSVPGEEERLVRV

SEQ ID NO: 1735 - protein, 55 aa, Artificial
  Synthetic peptide
MGLSDGEWQLVLNVWGKVEADIPGHGQEVLIRLFKGHPETLEKFDKFKHLKSEDE

SEQ ID NO: 1736 - protein, 55 aa, Artificial; identical to SEQ ID NO: 1735
  Synthetic peptide

SEQ ID NO: 1737 - protein, 111 aa, Artificial
  Synthetic peptide
RGAGEREAGQQSAPVTPCALPGVPGQRVRRGFAVPLIQEGAHGDGAALRRAAGACLLPLHLQGLHGRVRAYEAGGGSRAMARPSSPDGPPPPPHLTWPCAGAGSAAAMWRW

SEQ ID NO: 1738 - protein, 26 aa, Artificial
  Synthetic peptide
VRTRRVGARGPWPGPPRPMGHPLLRT

SEQ ID NO: 1739 - protein, 125 aa, Artificial
  Synthetic peptide
RGAGEREAGQQSAPVTPCALPGVPGQRVRRGFAVPLIQEGAHGDGAALRRAAGACLLPLHLQGLHGRVRVPRRLCGGGEHGRCSAAADAEADECAAVPAGARTGPAGPGGQPARAHRPLLCAVPG

SEQ ID NO: 1740 - protein, 61 aa, Artificial
  Synthetic peptide
SPGRLWSPLYLLLMPGGVGWGGCWAPASLQVPNKAVWQSDSKKEALAAAWPAPTCLPFLQA

SEQ ID NO: 1741 - protein, 110 aa, Artificial
  Synthetic peptide
MWVLGIAATFCGLFLLPGFALQIQCYQCEEFQLNNDCSSPEFIVNCTVNVQDMCQKEVMEQSAGIMYRKSCASSAACLIASAGSPCRGLAPGREEQRALHKAGAVGGGVR

SEQ ID NO: 1742 - protein, 139 aa, Artificial
  Synthetic peptide
SPCRGLAPGREEQRALHKAGAVGGGVRMYAQALLVVGVLQRQAAAQHLHEHPPKLLRGHRVQERVDDRAEVEKRLREGEEDHVRPEVGPRPVVLGFGRSHDPPNLVGHPAYGQCHNNQPWADTSRRERQRKEKHSMRTQ

SEQ ID NO: 1743 - protein, 29 aa, Artificial
  Synthetic peptide
SHCVTRLECSGTISAHCNLCLPGSNDHPT

SEQ ID NO: 1744 - protein, 5 aa, Artificial
  Synthetic peptide
MWVLG

SEQ ID NO: 1745 - protein, 21 aa, Artificial
  Synthetic peptide
DTKRTNTLLFEMRHFAKQLTT

SEQ ID NO: 1746 - protein, 27 aa, Artificial
  Synthetic peptide
DRVSLCHEAGVQWNNFSTLQPLPPRLK

SEQ ID NO: 1747 - protein, 5 aa, Artificial
  Synthetic peptide
MWVLG

SEQ ID NO: 1748 - protein, 8 aa, Artificial
  Synthetic peptide
GNPAPSAV

SEQ ID NO: 1749 - protein, 81 aa, Artificial
  Synthetic peptide
CEYICSSLAQAASPNPQGQRQDFSVPLRFKYTDPQPWTSRLSVTFCPRKTWADQVLTKNRRGGAASVLGGSGSTPYDGRNR

SEQ ID NO: 1750 - protein, 44 aa, Artificial
  Synthetic peptide
GKWLPGASASYSGVESIWFSPKSQEDIFFPSLCSMGTRKSQILS

SEQ ID NO: 1751 - protein, 23 aa, Artificial
  Synthetic peptide
DAMVVSSRPKATTHRKSRTLSRR

SEQ ID NO: 1752 - protein, 6 aa, Artificial
  Synthetic peptide
RSKRNL

SEQ ID NO: 1753 - protein, 13 aa, Artificial
  Synthetic peptide
LLWLRGKVSFYCF

SEQ ID NO: 1754 - protein, 69 aa, Artificial
  Synthetic peptide
DCGFPAFRELKRAETVSPVFFTRRCIWEDLKSTGFSPAGGGRPPGGGPRTQEDSGLPCWRSSCSVTLQV

SEQ ID NO: 1755 - protein, 20 aa, Artificial
  Synthetic peptide
VPIGWVLSPSPTSLRAPLPG

SEQ ID NO: 1756 - protein, 31 aa, Artificial
  Synthetic peptide
ERQDLTMLSRLVLNSWPQMILPPQPPKVLEL

SEQ ID NO: 1757 - protein, 7 aa, Artificial
  Synthetic peptide
TQGVVGD

SEQ ID NO: 1758 - protein, 15 aa, Artificial
  Synthetic peptide
VPGAVGQGRKHLGRV

SEQ ID NO: 1759 - protein, 29 aa, Artificial
  Synthetic peptide
PHKYSAHGRTRHFESATRTTNGAQKLSRI

SEQ ID NO: 1760 - protein, 751 aa, Artificial
  Synthetic peptide
MKYSCCALVLAVLGTELLGSLCSTVRSPRFRGRIQQERKNIRPNIILVLTDDQDVELAFFGKYLNEYNGSYIPPGWREWLGLIKNSRFYNYTVCRNGIKEKHGFDYAKDYFTDLITNESINYFKMSKRMYPHRPVMMVISHAAPHGPEDSAPQFSKLYPNASQHITPSYNYAPNMDKHWIMQYTGPMLPIHMEFTNILQRKRLQTLMSVDDSVERLYNMLVETGELENTYIIYTADHGYHIGQFGLVKGKSMPYDFDIRVPFFIRGPSVEPGSIVPQIVLNIDLAPTILDIAGLDTPPDVDGKSVLKLLDPEKPGNRFRTNKKAKIWRDTFLVERGKFLRKKEESSKNIQQSNHLPKYERVKELCQQARYQTACEQPGQKWQCIEDTSGKLRIHKCKGPSDLLTVRQSTRNLYARGFHDKDKECSCRESGYRASRSQRKSQRQFLRNQGTPKYKPRFVHTRQTRSLSVEFEGEIYDINLEEEEELQVLQPRNIAKRHDEGHKGPRDLQASSGGNRGRMLADSSNAVGPPTTVRVTHKCFILPNDSIHCERELYQSARAWKDHKAYIDKEIEALQDKIKNLREVRGHLKRRKPEECSCSKQSYYNKEKGVKKQEKLKSHLHPFKEAAQEVDSKLQLFKENNRRRKKERKEKRRQRKGEECSLPGLTCFTHDNNHWQTAPFWNLGSFCACTSSNNNTYWCLRTVNETHNFLFCEFATGFLEYFDMNTDPYQLTNTVHTVERGILNQLHVQLME

SEQ ID NO: 1761 - protein, 13 aa, Artificial
  Synthetic peptide
CVIVPPLSQPQIH

SEQ ID NO: 1762 - protein, 22 aa, Artificial
  Synthetic peptide
ARYDGDQPRCAPRPRGLSPTVF

SEQ ID NO: 1763 - protein, 8 aa, Artificial
  Synthetic peptide
GLLHRLNH

SEQ ID NO: 1764 - protein, 15 aa, Artificial
  Synthetic peptide
DSLLQVLNVKEGTPS

SEQ ID NO: 1765 - protein, 13 aa, Artificial
  Synthetic peptide
GKPSLLLPHSLLG

SEQ ID NO: 1766 - protein, 57 aa, Artificial
  Synthetic peptide
MGRVRTLAGECSAQAQAQSLLAVVLSAPPSGGTPSARLSVRSPSPRDPWGLWAPVLQ

SEQ ID NO: 1767 - protein, 57 aa, Artificial; identical to SEQ ID NO: 1766
  Synthetic peptide

SEQ ID NO: 1768 - protein, 29 aa, Artificial
  Synthetic peptide
MKSLTATSSMKVLLPRTFWTRKLMKFLLL

SEQ ID NO: 1769 - protein, 44 aa, Artificial
  Synthetic peptide
MAEKALLCPSSAGLGTWPWVLNSAWPVLPLAVDQGVDWRPRGPV

SEQ ID NO: 1770 - protein, 76 aa, Artificial
  Synthetic peptide
VEELLSGNPHIEKESARSIADGAMMEAASVCMGQMEPDQVYEGITFEDFLKIWQGIDIETKMHVRFLNMETMALCH

SEQ ID NO: 1771 - protein, 14 aa, Artificial
  Synthetic peptide
TPASHLAMRQHHHH

SEQ ID NO: 1772 - protein, 28 aa, Artificial
  Synthetic peptide
YAPPLLTFLPTRPSCGSQDGKGPPHQVI

SEQ ID NO: 1773 - protein, 31 aa, Artificial
  Synthetic peptide
ARWLTPVIPALWEAETGGSRGQEMETIPANT

SEQ ID NO: 1774 - protein, 14 aa, Artificial
  Synthetic peptide
WKVHLPKGEGFSSG

SEQ ID NO: 1775 - protein, 80 aa, Artificial
  Synthetic peptide
GARLPRHATPCWCPDPPPGPGVPPTGWGPTLPSRAVLARSSAEGGQPRGTVSTAPGMGLGCSPGLCVGVPLPTSFPLALA

SEQ ID NO: 1776 - protein, 221 aa, Artificial
  Synthetic peptide
TQNRQGHLWPPRPRPLACRGPWSSASQPALSSSWAPCSCGFARPRRSRAPPRLPLPCLGTARRGRPATAAETRTFPRWPPSALALVWGCVRSMGLRQPPSTYWAQAQLLALSCTPNSTQTSTHTHTHTLTHTHTWRARSTSTSTISARRHRICSGHGGAGQTGRLGGWRTELQTKAGDPWRGGMASTPGSLCVRHSPWTHTHRHTHYLDACMHTHARTRAP

SEQ ID NO: 1777 - DNA, 20 bp, Homo sapiens
tgctgtcgcctcctctgatg

SEQ ID NO: 1778 - DNA, 20 bp, Homo sapiens
cctcagaaggcacatgaaag

SEQ ID NO: 1779 - DNA, 31 bp, Homo sapiens
atagctagcatgtgggtcctaggcatcgcgg

SEQ ID NO: 1780 - DNA, 30 bp, Homo sapiens
cccaagcttctaagtggtcaactgcttggc

SEQ ID NO: 1781 - protein, 15 aa, Homo sapiens
FFQGTTGVSTPAPGV

SEQ ID NO: 1782 - DNA, 1273 bp, Homo sapiens
atgaacagcttcagcaccagcgccttcggccccgtggccttcagcctgggcctgctgctggtgctgcctgccgccttccctgcccccgtgccccccatggagcaccatcaccatcatcaccaccacatcctgcgcttcccttggcagctggtgcaggagcaggtccgccagacaatggccgaggccctgaaagtgtggagcgacgtgacccccctgaccttcaccgaggtgcacgagggacgcgccgacatcatgatcgacttcgcccgctactggcacggcgacgacctgcccttcgacggccctggcggcatcctggcccacgcctttttccccaagacccaccgcgagggcgatgtgcacttcgactacgacgagacctggaccatcggcgacgatcagggcaccgacctgctgcaggtggcagcccacgagttcggccacgtgctgggcctgcagcacaccaccgccgccaaggccctgatgagcgccttctacaccttccgctaccccctgagcctgagccccgatgattgtcgcggcgtgcagcacctgtacggccagccctggcccaccgtgaccagccgcacccctgccctgggcccccaggccggcatcgataccaatgagatcgcccccctggagcccgacgcccctcccgatgcctgtgaggccagcttcgacgccgtgtccaccatccgcggcgagctgttcttcttcaaggccggctttgtgtggcgcctgcgcggagggcagctgcagcccggctaccccgccctggccagccgccactggcagggcctgcccagccctgtggacgccgccttcgaggacgcccagggccacatctggtttttccagggcgcccagtattgggtgtacgacggcgagaagcctgtgctgggccctgcccctctgaccgagctgggccttgtgcgcttccccgtgcacgccgcccttgtgtggggccctgaaaagaacaagatctacttcttccggggacgcgactactggcgcttccaccccagcacccgccgcgtggatagccccgtccctcgccgcgccaccgactggcgcggcgtgcctagcgagatcgatgccgcctttcaggatgccgatggctacgcctacttcctgcgcggacggctgtactggaagttcgaccccgtgaaggtgaaggccctggagggcttcccccgccttgtgggccccgacttcttcggctgtgccgagcctgccaacaccttcctgtgatgagtttaaacgcggccgc

SEQ ID NO: 1783 - DNA, 919 bp, Homo sapiens
atgaacagcttcagcaccagcgccttcggccccgtggccttcagcctgggcctgctgctggtgctgcctgccgccttccctgcccccgtgccccccatggagcaccaccatcaccatcaccaccacatcctgcgcttcccttggcagctggtgcaggagcaggtccgccagacaatggccgaggccctgaaagtgtggagcgacgtgacccccctgaccttcaccgaggtgcacgagggacgggccgacatcatgatcgacttcgcccggtactggcacggcgatgacctgcccttcgacggccctggcggcatcctggcccacgcctttttccccaagacccaccgggagggcgacgtgcacttcgactacgacgagacctggaccatcggcgacgaccagggcaccgacctgctgcaggtggccgcccacgagttcggccacgtgctgggcctgcagcacaccaccgccgccaaggccctgatgagcgccttctacaccttccgctaccctctgagcctgagccccgacgactgtcggggcgtgcagcacctgtacggccagccctggcccaccgtgaccagccggacccctgccctgggccctcaggccggcatcgacaccaacgagatcgcccccctggagcccgacgcccctcccgatgcctgtgaggccagcttcgacgccgtgtccaccatccggggcgagctgttcttcttcaaggccggctttgtgtggcggctgcgcggagggcagctgcagcccggctaccccgccctggccagccggcactggcagggcctgcccagccctgtggacgccgccttcgaggacgcccagggccacatctggttcttccagggcaccaccggcgtgtccacccctgcccctggcgtgtaatgagtttaaacgcggccgc

SEQ ID NO: 1784 - protein, 417 aa, Homo sapiens
MNSFSTSAFGPVAFSLGLLLVLPAAFPAPVPPMEHHHHHHHHILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 1785 - protein, 299 aa, Homo sapiens
MNSFSTSAFGPVAFSLGLLLVLPAAFPAPVPPMEHHHHHHHHILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 1786 - protein, 385 aa, Homo sapiens
MEHHHHHHHHILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGAQYWVYDGEKPVLGPAPLTELGLVRFPVHAALVWGPEKNKIYFFRGRDYWRFHPSTRRVDSPVPRRATDWRGVPSEIDAAFQDADGYAYFLRGRLYWKFDPVKVKALEGFPRLVGPDFFGCAEPANTFL

SEQ ID NO: 1787 - protein, 267 aa, Homo sapiens
MEHHHHHHHHILRFPWQLVQEQVRQTMAEALKVWSDVTPLTFTEVHEGRADIMIDFARYWHGDDLPFDGPGGILAHAFFPKTHREGDVHFDYDETWTIGDDQGTDLLQVAAHEFGHVLGLQHTTAAKALMSAFYTFRYPLSLSPDDCRGVQHLYGQPWPTVTSRTPALGPQAGIDTNEIAPLEPDAPPDACEASFDAVSTIRGELFFFKAGFVWRLRGGQLQPGYPALASRHWQGLPSPVDAAFEDAQGHIWFFQGTTGVSTPAPGV

SEQ ID NO: 1788 - protein, 138 aa, Homo sapiens [sequence omitted]

SEQ ID NO: 1789 - protein, 141 aa, Homo sapiens [sequence omitted]

SEQ ID NO: 1790 - DNA, 445 bp, Homo sapiens
gaattcgccaccatgaacagcttcagcaccagcgccttcggccccgtggccttcagcctgggcctgctgctggtgctgcctgccgccttccctgcccccgtgccccccatggagcaccaccaccatcaccaccaccatagcaccggcgagagcagcagcgtgtccgagcgcggcagcctgaagcagcagctgcgcgagtacatccgctgggaggaggccgctcgcaacctgctgggcctgatcgaggccaaggagaaccggaatcaccagcccccccagcccaaggccctgggcaaccagcagcccagctgggacagcgaggacagcagcaacttcaaggatgtgggcagcaagggcaaagtgggccggctgtccgcccctggcagccagcgcgagggccggaaccctcagctgaaccagcagtgatgagtttaaacgcggccgc

SEQ ID NO: 1791 - DNA, 427 bp, Homo sapiens
gaattcgccaccatgaacagcttcagcaccagcgccttcggccccgtggccttcagcctgggcctgctcctggtgctgcctgccgccttccctgcccccgtgccccccatggagcaccatcatcaccatcatcatcacagcaccggcgagagcagcagcgtgtccgagcgcggcagcctgaagcagcagctgcgcgagtacatccgctgggaggaggccgctcgcaacctgctgggcctgatcgaggccaaggagaaccggaatcaccagcccccccagcccaaggccctgggcaaccagcagcccagctgggacagcgaggacagcagcaacttcaaggatgtgggcagcaagggcaaggacagcctgctgcaggtgctgaatgtgaaggaaggcacccccagctaatgagtttaaacgcggccgc

SEQ ID NO: 1792 - protein, 137 aa, Homo sapiens
MNSFSTSAFGPVAFSLGLLLVLPAAFPAPVPPMEHHHHHHHHSTGESSSVSERGSLKQQLREYIRWEEAARNLLGLIEAKENRNHQPPQPKALGNQQPSWDSEDSSNFKDVGSKGKVGRLSAPGSQREGRNPQLNQQ

SEQ ID NO: 1793 - protein, 131 aa, Homo sapiens
MNSFSTSAFGPVAFSLGLLLVLPAAFPAPVPPMEHHHHHHHHSTGESSSVSERGSLKQQLREYIRWEEAARNLLGLIEAKENRNHQPPQPKALGNQQPSWDSEDSSNFKDVGSKGKDSLLQVLNVKEGTPS

SEQ ID NO: 1794 - protein, 16 aa, Homo sapiens
DSLLQVLNVKEGTPSC

SEQ ID NO: 1795 - protein, 11 aa, Homo sapiens
SKGKDSLLQVL

SEQ ID NO: 1796 - DNA, 23 bp, Artificial Organism
  Synthetic oligonucleotide
agctccacaaaatctgtcacagc

SEQ ID NO: 1797 - DNA, 16 bp, Artificial Organism
  Synthetic oligonucleotide
tgatccgcccgtctcg

SEQ ID NO: 1798 - DNA, 101 bp, Artificial Organism
  Synthetic oligonucleotide
agctccacaaaatctgtcacagcagggcttttcaacactgggaggcacggtggctcacgcctgtaatcccagcactttgggaggccgagacgggcggatca

SEQ ID NO: 1799 - DNA, 23 bp, Artificial Organism
  Synthetic oligonucleotide
aacaaccgtaggaggaagaagga

SEQ ID NO: 1800 - DNA, 25 bp, Artificial Organism
  Synthetic oligonucleotide
gtgtgcactgtatttgtgagggttc

SEQ ID NO: 1801 - DNA, 150 bp, Artificial Organism
  Synthetic oligonucleotide
aacaaccgtaggaggaagaaggagaggaaggagaagagacggcagaggaagggggaagagtgcagcctgcctggcctcacttgcttcacgcatgacaacaaccactggcagacagccccgttctggaaccctcacaaatacagtgcacac
